United States Patent 8,765,931 (DOUBLE-STRANDED OLIGONUCLEOTIDE COMPOUND FOR DOWN-REGULATING THE EXPRESSION OF CASP2 GENE) - sequence listing, part 2

SEQ ID NO: 33595 - RNA, 19 nt, artificial
  Oligomer
uaagacauggucuaccugu

SEQ ID NO: 33596 - RNA, 19 nt, Artificial
  Oligomer
uauucacagaaaaauaagc
